United States Patent 10,336,808 (MHC PEPTIDE COMPLEXES AND USES THEREOF IN INFECTIOUS DISEASES) - sequence listing, part 3

SEQ ID NO: 60883 - protein, 9 aa, BK Virus
IFFLTPHRH

SEQ ID NO: 60884 - protein, 15 aa, BK Virus
KLMEKYSVTFISRHM

SEQ ID NO: 60885 - protein, 9 aa, BK Virus
YSVTFISRH

SEQ ID NO: 60886 - protein, 15 aa, BK Virus
IIFFLTPHRHRVSAI

SEQ ID NO: 60887 - protein, 9 aa, BK Virus
IFFLTPHRH

SEQ ID NO: 60888 - protein, 15 aa, BK Virus
LMEKYSVTFISRHMC

SEQ ID NO: 60889 - protein, 9 aa, BK Virus
YSVTFISRH

SEQ ID NO: 60890 - protein, 15 aa, BK Virus
EQYMAGVAWLHCLLP

SEQ ID NO: 60891 - protein, 9 aa, BK Virus
YMAGVAWLH

SEQ ID NO: 60892 - protein, 15 aa, BK Virus
LEQYMAGVAWLHCLL

SEQ ID NO: 60893 - protein, 9 aa, BK Virus
YMAGVAWLH

SEQ ID NO: 60894 - protein, 15 aa, BK Virus
AGHNIIFFLTPHRHR

SEQ ID NO: 60895 - protein, 9 aa, BK Virus
IFFLTPHRH

SEQ ID NO: 60896 - protein, 15 aa, BK Virus
IFFLTPHRHRVSAIN

SEQ ID NO: 60897 - protein, 9 aa, BK Virus
IFFLTPHRH

SEQ ID NO: 60898 - protein, 15 aa, BK Virus
NKEYLLYSALTRDPY

SEQ ID NO: 60899 - protein, 9 aa, BK Virus
YLLYSALTR

SEQ ID NO: 60900 - protein, 15 aa, BK Virus
KEYLLYSALTRDPYH

SEQ ID NO: 60901 - protein, 9 aa, BK Virus
YLLYSALTR

SEQ ID NO: 60902 - protein, 15 aa, BK Virus
PDFGTWNSSEVPTYG

SEQ ID NO: 60903 - protein, 9 aa, BK Virus
WNSSEVPTY

SEQ ID NO: 60904 - protein, 15 aa, BK Virus
QPDFGTWNSSEVPTY

SEQ ID NO: 60905 - protein, 9 aa, BK Virus
FGTWNSSEV

SEQ ID NO: 60906 - protein, 15 aa, BK Virus
VNKEYLLYSALTRDP

SEQ ID NO: 60907 - protein, 9 aa, BK Virus
YLLYSALTR

SEQ ID NO: 60908 - protein, 15 aa, BK Virus
AVLEQYMAGVAWLHC

SEQ ID NO: 60909 - protein, 9 aa, BK Virus
LEQYMAGVA

SEQ ID NO: 60910 - protein, 15 aa, BK Virus
NAVLEQYMAGVAWLH

SEQ ID NO: 60911 - protein, 9 aa, BK Virus
LEQYMAGVA

SEQ ID NO: 60912 - protein, 15 aa, BK Virus
YLLYSALTRDPYHII

SEQ ID NO: 60913 - protein, 9 aa, BK Virus
YSALTRDPY

SEQ ID NO: 60914 - protein, 15 aa, BK Virus
LLYSALTRDPYHIIE

SEQ ID NO: 60915 - protein, 9 aa, BK Virus
YSALTRDPY

SEQ ID NO: 60916 - protein, 15 aa, BK Virus
EYLLYSALTRDPYHI

SEQ ID NO: 60917 - protein, 9 aa, BK Virus
YSALTRDPY

SEQ ID NO: 60918 - protein, 15 aa, BK Virus
NKEYLLYSALTRDPY

SEQ ID NO: 60919 - protein, 9 aa, BK Virus
YLLYSALTR

SEQ ID NO: 60920 - protein, 15 aa, BK Virus
GDEDKMKRMNTLYKK

SEQ ID NO: 60921 - protein, 9 aa, BK Virus
MKRMNTLYK

SEQ ID NO: 60922 - protein, 15 aa, BK Virus
KEYLLYSALTRDPYH

SEQ ID NO: 60923 - protein, 9 aa, BK Virus
YSALTRDPY

SEQ ID NO: 60924 - protein, 15 aa, BK Virus
EDKMKRMNTLYKKME

SEQ ID NO: 60925 - protein, 9 aa, BK Virus
MKRMNTLYK

SEQ ID NO: 60926 - protein, 15 aa, BK Virus
DEDKMKRMNTLYKKM

SEQ ID NO: 60927 - protein, 9 aa, BK Virus
MKRMNTLYK

SEQ ID NO: 60928 - protein, 15 aa, BK Virus
DKMKRMNTLYKKMEQ

SEQ ID NO: 60929 - protein, 9 aa, BK Virus
MKRMNTLYK

SEQ ID NO: 60930 - protein, 15 aa, BK Virus
GGDEDKMKRMNTLYK

SEQ ID NO: 60931 - protein, 9 aa, BK Virus
EDKMKRMNT

SEQ ID NO: 60932 - protein, 15 aa, BK Virus
GLERAAWGNLPLMRK

SEQ ID NO: 60933 - protein, 9 aa, BK Virus
AWGNLPLMR

SEQ ID NO: 60934 - protein, 15 aa, BK Virus
LERAAWGNLPLMRKA

SEQ ID NO: 60935 - protein, 9 aa, BK Virus
WGNLPLMRK

SEQ ID NO: 60936 - protein, 15 aa, BK Virus
RAAWGNLPLMRKAYL

SEQ ID NO: 60937 - protein, 9 aa, BK Virus
WGNLPLMRK

SEQ ID NO: 60938 - protein, 15 aa, BK Virus
ERAAWGNLPLMRKAY

SEQ ID NO: 60939 - protein, 9 aa, BK Virus
WGNLPLMRK

SEQ ID NO: 60940 - protein, 15 aa, BK Virus
GLERAAWGNLPLMRK

SEQ ID NO: 60941 - protein, 9 aa, BK Virus
LERAAWGNL

SEQ ID NO: 60942 - protein, 15 aa, BK Virus
RAAWGNLPLMRKAYL

SEQ ID NO: 60943 - protein, 9 aa, BK Virus
WGNLPLMRK

SEQ ID NO: 60944 - protein, 15 aa, BK Virus
AAWGNLPLMRKAYLK

SEQ ID NO: 60945 - protein, 9 aa, BK Virus
WGNLPLMRK

SEQ ID NO: 60946 - protein, 15 aa, BK Virus
LERAAWGNLPLMRKA

SEQ ID NO: 60947 - protein, 9 aa, BK Virus
WGNLPLMRK

SEQ ID NO: 60948 - protein, 15 aa, BK Virus
ERAAWGNLPLMRKAY

SEQ ID NO: 60949 - protein, 9 aa, BK Virus
WGNLPLMRK

SEQ ID NO: 60950 - protein, 15 aa, BK Virus
EDVFLLLGMYLEFQY

SEQ ID NO: 60951 - protein, 9 aa, BK Virus
FLLLGMYLE

SEQ ID NO: 60952 - protein, 15 aa, BK Virus
CGGKALNVNLPMERL

SEQ ID NO: 60953 - protein, 9 aa, BK Virus
LNVNLPMER

SEQ ID NO: 60954 - protein, 15 aa, BK Virus
GGKALNVNLPMERLT

SEQ ID NO: 60955 - protein, 9 aa, BK Virus
LNVNLPMER

SEQ ID NO: 60956 - protein, 15 aa, BK Virus
LEKRILQSGMTLLLL

SEQ ID NO: 60957 - protein, 9 aa, BK Virus
ILQSGMTLL

SEQ ID NO: 60958 - protein, 15 aa, BK Virus
LCGGKALNVNLPMER

SEQ ID NO: 60959 - protein, 9 aa, BK Virus
GKALNVNLP

SEQ ID NO: 60960 - protein, 15 aa, BK Virus
LLEKRILQSGMTLLL

SEQ ID NO: 60961 - protein, 9 aa, BK Virus
ILQSGMTLL

SEQ ID NO: 60962 - protein, 15 aa, BK Virus
GKALNVNLPMERLTF

SEQ ID NO: 60963 - protein, 9 aa, BK Virus
LNVNLPMER

SEQ ID NO: 60964 - protein, 15 aa, BK Virus
CEDVFLLLGMYLEFQ

SEQ ID NO: 60965 - protein, 9 aa, BK Virus
FLLLGMYLE

SEQ ID NO: 60966 - protein, 15 aa, BK Virus
KCEDVFLLLGMYLEF

SEQ ID NO: 60967 - protein, 9 aa, BK Virus
FLLLGMYLE

SEQ ID NO: 60968 - protein, 15 aa, BK Virus
EKRILQSGMTLLLLL

SEQ ID NO: 60969 - protein, 9 aa, BK Virus
ILQSGMTLL

SEQ ID NO: 60970 - protein, 15 aa, BK Virus
TKCEDVFLLLGMYLE

SEQ ID NO: 60971 - protein, 9 aa, BK Virus
VFLLLGMYL

SEQ ID NO: 60972 - protein, 15 aa, BK Virus
KRILQSGMTLLLLLI

SEQ ID NO: 60973 - protein, 9 aa, BK Virus
ILQSGMTLL

SEQ ID NO: 60974 - protein, 15 aa, BK Virus
DVFLLLGMYLEFQYN

SEQ ID NO: 60975 - protein, 9 aa, BK Virus
FLLLGMYLE

SEQ ID NO: 60976 - protein, 15 aa, BK Virus
DFLHCVVFNVPKRRY

SEQ ID NO: 60977 - protein, 9 aa, BK Virus
VVFNVPKRR

SEQ ID NO: 60978 - protein, 15 aa, BK Virus
LHCVVFNVPKRRYWL

SEQ ID NO: 60979 - protein, 9 aa, BK Virus
VFNVPKRRY

SEQ ID NO: 60980 - protein, 15 aa, BK Virus
FLHCVVFNVPKRRYW

SEQ ID NO: 60981 - protein, 9 aa, BK Virus
VFNVPKRRY

SEQ ID NO: 60982 - protein, 15 aa, BK Virus
DEDKMKRMNTLYKKM

SEQ ID NO: 60983 - protein, 9 aa, BK Virus
MKRMNTLYK

SEQ ID NO: 60984 - protein, 15 aa, BK Virus
KALNVNLPMERLTFE

SEQ ID NO: 60985 - protein, 9 aa, BK Virus
LNVNLPMER

SEQ ID NO: 60986 - protein, 15 aa, BK Virus
EDKMKRMNTLYKKME

SEQ ID NO: 60987 - protein, 9 aa, BK Virus
MKRMNTLYK

SEQ ID NO: 60988 - protein, 15 aa, BK Virus
ISMYTFSRMKYNICM

SEQ ID NO: 60989 - protein, 9 aa, BK Virus
MYTFSRMKY

SEQ ID NO: 60990 - protein, 15 aa, BK Virus
DKMKRMNTLYKKMEQ

SEQ ID NO: 60991 - protein, 9 aa, BK Virus
MKRMNTLYK

SEQ ID NO: 60992 - protein, 15 aa, BK Virus
HCVVFNVPKRRYWLF

SEQ ID NO: 60993 - protein, 9 aa, BK Virus
VFNVPKRRY

SEQ ID NO: 60994 - protein, 15 aa, BK Virus
GDEDKMKRMNTLYKK

SEQ ID NO: 60995 - protein, 9 aa, BK Virus
MKRMNTLYK

SEQ ID NO: 60996 - protein, 15 aa, BK Virus
FLLEKRILQSGMTLL

SEQ ID NO: 60997 - protein, 9 aa, BK Virus
KRILQSGMT

SEQ ID NO: 60998 - protein, 15 aa, BK Virus
EISMYTFSRMKYNIC

SEQ ID NO: 60999 - protein, 9 aa, BK Virus
ISMYTFSRM

SEQ ID NO: 61000 - protein, 15 aa, BK Virus
WGNLPLMRKAYLKKC

SEQ ID NO: 61001 - protein, 9 aa, BK Virus
WGNLPLMRK

SEQ ID NO: 61002 - protein, 15 aa, BK Virus
AWGNLPLMRKAYLKK

SEQ ID NO: 61003 - protein, 9 aa, BK Virus
WGNLPLMRK

SEQ ID NO: 61004 - protein, 15 aa, BK Virus
GGDEDKMKRMNTLYK

SEQ ID NO: 61005 - protein, 9 aa, BK Virus
DKMKRMNTL

SEQ ID NO: 61006 - protein, 15 aa, BK Virus
LPSGHGINNLDSLRD

SEQ ID NO: 61007 - protein, 9 aa, BK Virus
HGINNLDSL

SEQ ID NO: 61008 - protein, 15 aa, BK Virus
SGHGINNLDSLRDYL

SEQ ID NO: 61009 - protein, 9 aa, BK Virus
INNLDSLRD

SEQ ID NO: 61010 - protein, 15 aa, BK Virus
PSGHGINNLDSLRDY

SEQ ID NO: 61011 - protein, 9 aa, BK Virus
INNLDSLRD

SEQ ID NO: 61012 - protein, 15 aa, BK Virus
RILQSGMTLLLLLIW

SEQ ID NO: 61013 - protein, 9 aa, BK Virus
LQSGMTLLL

SEQ ID NO: 61014 - protein, 15 aa, BK Virus
VFLLLGMYLEFQYNV

SEQ ID NO: 61015 - protein, 9 aa, BK Virus
FLLLGMYLE

SEQ ID NO: 61016 - protein, 15 aa, BK Virus
CVVFNVPKRRYWLFK

SEQ ID NO: 61017 - protein, 9 aa, BK Virus
VFNVPKRRY

SEQ ID NO: 61018 - protein, 15 aa, BK Virus
IFPPGLVTMNEYPVP

SEQ ID NO: 61019 - protein, 9 aa, BK Virus
PGLVTMNEY

SEQ ID NO: 61020 - protein, 15 aa, BK Virus
GHGINNLDSLRDYLD

SEQ ID NO: 61021 - protein, 9 aa, BK Virus
INNLDSLRD

SEQ ID NO: 61022 - protein, 15 aa, BK Virus
FPPGLVTMNEYPVPK

SEQ ID NO: 61023 - protein, 9 aa, BK Virus
PGLVTMNEY

SEQ ID NO: 61024 - protein, 15 aa, BK Virus
YLLYSALTRDPYHII

SEQ ID NO: 61025 - protein, 9 aa, BK Virus
YSALTRDPY

SEQ ID NO: 61026 - protein, 15 aa, BK Virus
HGINNLDSLRDYLDG

SEQ ID NO: 61027 - protein, 9 aa, BK Virus
INNLDSLRD

SEQ ID NO: 61028 - protein, 15 aa, BK Virus
ILQSGMTLLLLLIWF

SEQ ID NO: 61029 - protein, 9 aa, BK Virus
ILQSGMTLL

SEQ ID NO: 61030 - protein, 15 aa, BK Virus
ALNVNLPMERLTFEL

SEQ ID NO: 61031 - protein, 9 aa, BK Virus
LNVNLPMER

SEQ ID NO: 61032 - protein, 15 aa, BK Virus
SEISMYTFSRMKYNI

SEQ ID NO: 61033 - protein, 9 aa, BK Virus
ISMYTFSRM

SEQ ID NO: 61034 - protein, 15 aa, BK Virus
KMKRMNTLYKKMEQD

SEQ ID NO: 61035 - protein, 9 aa, BK Virus
MKRMNTLYK

SEQ ID NO: 61036 - protein, 15 aa, BK Virus
AGHNIIFFLTPHRHR

SEQ ID NO: 61037 - protein, 9 aa, BK Virus
IIFFLTPHR

SEQ ID NO: 61038 - protein, 15 aa, BK Virus
GHNIIFFLTPHRHRV

SEQ ID NO: 61039 - protein, 9 aa, BK Virus
IIFFLTPHR

SEQ ID NO: 61040 - protein, 15 aa, BK Virus
MTLLLLLIWFRPVAD

SEQ ID NO: 61041 - protein, 9 aa, BK Virus
LLLLLIWFR

SEQ ID NO: 61042 - protein, 15 aa, BK Virus
GMTLLLLLIWFRPVA

SEQ ID NO: 61043 - protein, 9 aa, BK Virus
LLLLLIWFR

SEQ ID NO: 61044 - protein, 15 aa, BK Virus
CAGHNIIFFLTPHRH

SEQ ID NO: 61045 - protein, 9 aa, BK Virus
IIFFLTPHR

SEQ ID NO: 61046 - protein, 15 aa, BK Virus
HNIIFFLTPHRHRVS

SEQ ID NO: 61047 - protein, 9 aa, BK Virus
IIFFLTPHR

SEQ ID NO: 61048 - protein, 15 aa, BK Virus
TLLLLLIWFRPVADF

SEQ ID NO: 61049 - protein, 9 aa, BK Virus
LLLLLIWFR

SEQ ID NO: 61050 - protein, 15 aa, BK Virus
LLLLLIWFRPVADFS

SEQ ID NO: 61051 - protein, 9 aa, BK Virus
LLIWFRPVA

SEQ ID NO: 61052 - protein, 15 aa, BK Virus
MCAGHNIIFFLTPHR

SEQ ID NO: 61053 - protein, 9 aa, BK Virus
NIIFFLTPH

SEQ ID NO: 61054 - protein, 15 aa, BK Virus
SGMTLLLLLIWFRPV

SEQ ID NO: 61055 - protein, 9 aa, BK Virus
LLLLLIWFR

SEQ ID NO: 61056 - protein, 15 aa, BK Virus
NIIFFLTPHRHRVSA

SEQ ID NO: 61057 - protein, 9 aa, BK Virus
IIFFLTPHR

SEQ ID NO: 61058 - protein, 15 aa, BK Virus
QSGMTLLLLLIWFRP

SEQ ID NO: 61059 - protein, 9 aa, BK Virus
LLLLLIWFR

SEQ ID NO: 61060 - protein, 15 aa, BK Virus
IIFFLTPHRHRVSAI

SEQ ID NO: 61061 - protein, 9 aa, BK Virus
IIFFLTPHR

SEQ ID NO: 61062 - protein, 15 aa, BK Virus
LLLLIWFRPVADFSK

SEQ ID NO: 61063 - protein, 9 aa, BK Virus
LLIWFRPVA

SEQ ID NO: 61064 - protein, 15 aa, BK Virus
LQSGMTLLLLLIWFR

SEQ ID NO: 61065 - protein, 9 aa, BK Virus
TLLLLLIWF

SEQ ID NO: 61066 - protein, 15 aa, BK Virus
DEDKMKRMNTLYKKM

SEQ ID NO: 61067 - protein, 9 aa, BK Virus
MKRMNTLYK

SEQ ID NO: 61068 - protein, 15 aa, BK Virus
EDKMKRMNTLYKKME

SEQ ID NO: 61069 - protein, 9 aa, BK Virus
MKRMNTLYK

SEQ ID NO: 61070 - protein, 15 aa, BK Virus
WGNLPLMRKAYLKKC

SEQ ID NO: 61071 - protein, 9 aa, BK Virus
LMRKAYLKK

SEQ ID NO: 61072 - protein, 15 aa, BK Virus
DKMKRMNTLYKKMEQ

SEQ ID NO: 61073 - protein, 9 aa, BK Virus
MKRMNTLYK

SEQ ID NO: 61074 - protein, 15 aa, BK Virus
GDEDKMKRMNTLYKK

SEQ ID NO: 61075 - protein, 9 aa, BK Virus
MKRMNTLYK

SEQ ID NO: 61076 - protein, 15 aa, BK Virus
AWGNLPLMRKAYLKK

SEQ ID NO: 61077 - protein, 9 aa, BK Virus
LPLMRKAYL

SEQ ID NO: 61078 - protein, 15 aa, BK Virus
GNLPLMRKAYLKKCK

SEQ ID NO: 61079 - protein, 9 aa, BK Virus
LMRKAYLKK

SEQ ID NO: 61080 - protein, 15 aa, BK Virus
GGDEDKMKRMNTLYK

SEQ ID NO: 61081 - protein, 9 aa, BK Virus
DKMKRMNTL

SEQ ID NO: 61082 - protein, 15 aa, BK Virus
NLPLMRKAYLKKCKE

SEQ ID NO: 61083 - protein, 9 aa, BK Virus
LMRKAYLKK

SEQ ID NO: 61084 - protein, 15 aa, BK Virus
DFRPKIYLRKSLQNS

SEQ ID NO: 61085 - protein, 9 aa, BK Virus
DFRPKIYLR

SEQ ID NO: 61086 - protein, 15 aa, BK Virus
GVNKEYLLYSALTRD

SEQ ID NO: 61087 - protein, 9 aa, BK Virus
YLLYSALTR

SEQ ID NO: 61088 - protein, 15 aa, BK Virus
VNKEYLLYSALTRDP

SEQ ID NO: 61089 - protein, 9 aa, BK Virus
YLLYSALTR

SEQ ID NO: 61090 - protein, 15 aa, BK Virus
NKEYLLYSALTRDPY

SEQ ID NO: 61091 - protein, 9 aa, BK Virus
YLLYSALTR

SEQ ID NO: 61092 - protein, 15 aa, BK Virus
KEYLLYSALTRDPYH

SEQ ID NO: 61093 - protein, 9 aa, BK Virus
YLLYSALTR

SEQ ID NO: 61094 - protein, 15 aa, BK Virus
LPLMRKAYLKKCKEF

SEQ ID NO: 61095 - protein, 9 aa, BK Virus
LMRKAYLKK

SEQ ID NO: 61096 - protein, 15 aa, BK Virus
DFLHCVVFNVPKRRY

SEQ ID NO: 61097 - protein, 9 aa, BK Virus
CVVFNVPKR

SEQ ID NO: 61098 - protein, 15 aa, BK Virus
FLHCVVFNVPKRRYW

SEQ ID NO: 61099 - protein, 9 aa, BK Virus
CVVFNVPKR

SEQ ID NO: 61100 - protein, 15 aa, BK Virus
KGVNKEYLLYSALTR

SEQ ID NO: 61101 - protein, 9 aa, BK Virus
VNKEYLLYS

SEQ ID NO: 61102 - protein, 15 aa, BK Virus
LHCVVFNVPKRRYWL

SEQ ID NO: 61103 - protein, 9 aa, BK Virus
CVVFNVPKR

SEQ ID NO: 61104 - protein, 15 aa, BK Virus
FVRQIDFRPKIYLRK

SEQ ID NO: 61105 - protein, 9 aa, BK Virus
DFRPKIYLR

SEQ ID NO: 61106 - protein, 15 aa, BK Virus
VRQIDFRPKIYLRKS

SEQ ID NO: 61107 - protein, 9 aa, BK Virus
DFRPKIYLR

SEQ ID NO: 61108 - protein, 15 aa, BK Virus
RFVRQIDFRPKIYLR

SEQ ID NO: 61109 - protein, 9 aa, BK Virus
VRQIDFRPK

SEQ ID NO: 61110 - protein, 15 aa, BK Virus
FDFLHCVVFNVPKRR

SEQ ID NO: 61111 - protein, 9 aa, BK Virus
CVVFNVPKR

SEQ ID NO: 61112 - protein, 15 aa, BK Virus
LLLIWFRPVADFSKD

SEQ ID NO: 61113 - protein, 9 aa, BK Virus
LLIWFRPVA

SEQ ID NO: 61114 - protein, 15 aa, BK Virus
LMDLLGLERAAWGNL

SEQ ID NO: 61115 - protein, 9 aa, BK Virus
LMDLLGLER

SEQ ID NO: 61116 - protein, 15 aa, BK Virus
FRPKIYLRKSLQNSE

SEQ ID NO: 61117 - protein, 9 aa, BK Virus
YLRKSLQNS

SEQ ID NO: 61118 - protein, 15 aa, BK Virus
MELMDLLGLERAAWG

SEQ ID NO: 61119 - protein, 9 aa, BK Virus
LMDLLGLER

SEQ ID NO: 61120 - protein, 15 aa, BK Virus
SDLHQFLSQAVFSNR

SEQ ID NO: 61121 - protein, 9 aa, BK Virus
LHQFLSQAV

SEQ ID NO: 61122 - protein, 15 aa, BK Virus
CVVFNVPKRRYWLFK

SEQ ID NO: 61123 - protein, 9 aa, BK Virus
CVVFNVPKR

SEQ ID NO: 61124 - protein, 15 aa, BK Virus
KAQILYKKLMEKYSV

SEQ ID NO: 61125 - protein, 9 aa, BK Virus
ILYKKLMEK

SEQ ID NO: 61126 - protein, 15 aa, BK Virus
AQILYKKLMEKYSVT

SEQ ID NO: 61127 - protein, 9 aa, BK Virus
ILYKKLMEK

SEQ ID NO: 61128 - protein, 15 aa, BK Virus
QIDFRPKIYLRKSLQ

SEQ ID NO: 61129 - protein, 9 aa, BK Virus
DFRPKIYLR

SEQ ID NO: 61130 - protein, 15 aa, BK Virus
PKRRYWLFKGPIDSG

SEQ ID NO: 61131 - protein, 9 aa, BK Virus
WLFKGPIDS

SEQ ID NO: 61132 - protein, 15 aa, BK Virus
VPKRRYWLFKGPIDS

SEQ ID NO: 61133 - protein, 9 aa, BK Virus
KRRYWLFKG

SEQ ID NO: 61134 - protein, 15 aa, BK Virus
IDFRPKIYLRKSLQN

SEQ ID NO: 61135 - protein, 9 aa, BK Virus
FRPKIYLRK

SEQ ID NO: 61136 - protein, 15 aa, BK Virus
KRRYWLFKGPIDSGK

SEQ ID NO: 61137 - protein, 9 aa, BK Virus
WLFKGPIDS

SEQ ID NO: 61138 - protein, 15 aa, BK Virus
VVFNVPKRRYWLFKG

SEQ ID NO: 61139 - protein, 9 aa, BK Virus
PKRRYWLFK

SEQ ID NO: 61140 - protein, 15 aa, BK Virus
PLMRKAYLKKCKEFH

SEQ ID NO: 61141 - protein, 9 aa, BK Virus
LMRKAYLKK

SEQ ID NO: 61142 - protein, 15 aa, BK Virus
KMKRMNTLYKKMEQD

SEQ ID NO: 61143 - protein, 9 aa, BK Virus
MKRMNTLYK

SEQ ID NO: 61144 - protein, 15 aa, BK Virus
ILYKKLMEKYSVTFI

SEQ ID NO: 61145 - protein, 9 aa, BK Virus
ILYKKLMEK

SEQ ID NO: 61146 - protein, 15 aa, BK Virus
RPKIYLRKSLQNSEF

SEQ ID NO: 61147 - protein, 9 aa, BK Virus
YLRKSLQNS

SEQ ID NO: 61148 - protein, 15 aa, BK Virus
RQIDFRPKIYLRKSL

SEQ ID NO: 61149 - protein, 9 aa, BK Virus
DFRPKIYLR

SEQ ID NO: 61150 - protein, 15 aa, BK Virus
LLIWFRPVADFSKDI

SEQ ID NO: 61151 - protein, 9 aa, BK Virus
LLIWFRPVA

SEQ ID NO: 61152 - protein, 15 aa, BK Virus
HCVVFNVPKRRYWLF

SEQ ID NO: 61153 - protein, 9 aa, BK Virus
CVVFNVPKR

SEQ ID NO: 61154 - protein, 15 aa, BK Virus
SMELMDLLGLERAAW

SEQ ID NO: 61155 - protein, 9 aa, BK Virus
LMDLLGLER

SEQ ID NO: 61156 - protein, 15 aa, BK Virus
ISMYTFSRMKYNICM

SEQ ID NO: 61157 - protein, 9 aa, BK Virus
FSRMKYNIC

SEQ ID NO: 61158 - protein, 15 aa, BK Virus
MYTFSRMKYNICMGK

SEQ ID NO: 61159 - protein, 9 aa, BK Virus
FSRMKYNIC

SEQ ID NO: 61160 - protein, 15 aa, BK Virus
EISMYTFSRMKYNIC

SEQ ID NO: 61161 - protein, 9 aa, BK Virus
ISMYTFSRM

SEQ ID NO: 61162 - protein, 15 aa, BK Virus
YTFSRMKYNICMGKC

SEQ ID NO: 61163 - protein, 9 aa, BK Virus
FSRMKYNIC

SEQ ID NO: 61164 - protein, 15 aa, BK Virus
SMYTFSRMKYNICMG

SEQ ID NO: 61165 - protein, 9 aa, BK Virus
FSRMKYNIC

SEQ ID NO: 61166 - protein, 15 aa, BK Virus
TLLLLLIWFRPVADF

SEQ ID NO: 61167 - protein, 9 aa, BK Virus
LIWFRPVAD

SEQ ID NO: 61168 - protein, 15 aa, BK Virus
HNIIFFLTPHRHRVS

SEQ ID NO: 61169 - protein, 9 aa, BK Virus
IFFLTPHRH

SEQ ID NO: 61170 - protein, 15 aa, BK Virus
GHNIIFFLTPHRHRV

SEQ ID NO: 61171 - protein, 9 aa, BK Virus
IFFLTPHRH

SEQ ID NO: 61172 - protein, 15 aa, BK Virus
AGHNIIFFLTPHRHR

SEQ ID NO: 61173 - protein, 9 aa, BK Virus
IFFLTPHRH

SEQ ID NO: 61174 - protein, 15 aa, BK Virus
NIIFFLTPHRHRVSA

SEQ ID NO: 61175 - protein, 9 aa, BK Virus
IFFLTPHRH

SEQ ID NO: 61176 - protein, 15 aa, BK Virus
ARFVRQIDFRPKIYL

SEQ ID NO: 61177 - protein, 9 aa, BK Virus
VRQIDFRPK

SEQ ID NO: 61178 - protein, 15 aa, BK Virus
LLLLLIWFRPVADFS

SEQ ID NO: 61179 - protein, 9 aa, BK Virus
LIWFRPVAD

SEQ ID NO: 61180 - protein, 15 aa, BK Virus
CAGHNIIFFLTPHRH

SEQ ID NO: 61181 - protein, 9 aa, BK Virus
IIFFLTPHR

SEQ ID NO: 61182 - protein, 15 aa, BK Virus
TFSRMKYNICMGKCI

SEQ ID NO: 61183 - protein, 9 aa, BK Virus
FSRMKYNIC

SEQ ID NO: 61184 - protein, 15 aa, BK Virus
RFVRQIDFRPKIYLR

SEQ ID NO: 61185 - protein, 9 aa, BK Virus
VRQIDFRPK

SEQ ID NO: 61186 - protein, 15 aa, BK Virus
LLLLIWFRPVADFSK

SEQ ID NO: 61187 - protein, 9 aa, BK Virus
LIWFRPVAD

SEQ ID NO: 61188 - protein, 15 aa, BK Virus
FSRMKYNICMGKCIL

SEQ ID NO: 61189 - protein, 9 aa, BK Virus
FSRMKYNIC

SEQ ID NO: 61190 - protein, 15 aa, BK Virus
LLLIWFRPVADFSKD

SEQ ID NO: 61191 - protein, 9 aa, BK Virus
LIWFRPVAD

SEQ ID NO: 61192 - protein, 15 aa, BK Virus
LQARFVRQIDFRPKI

SEQ ID NO: 61193 - protein, 9 aa, BK Virus
VRQIDFRPK

SEQ ID NO: 61194 - protein, 15 aa, BK Virus
MTLLLLLIWFRPVAD

SEQ ID NO: 61195 - protein, 9 aa, BK Virus
LLLIWFRPV

SEQ ID NO: 61196 - protein, 15 aa, BK Virus
TLQARFVRQIDFRPK

SEQ ID NO: 61197 - protein, 9 aa, BK Virus
FVRQIDFRP

SEQ ID NO: 61198 - protein, 15 aa, BK Virus
QARFVRQIDFRPKIY

SEQ ID NO: 61199 - protein, 9 aa, BK Virus
VRQIDFRPK

SEQ ID NO: 61200 - protein, 15 aa, BK Virus
FVRQIDFRPKIYLRK

SEQ ID NO: 61201 - protein, 9 aa, BK Virus
RQIDFRPKI

SEQ ID NO: 61202 - protein, 15 aa, BK Virus
VRQIDFRPKIYLRKS

SEQ ID NO: 61203 - protein, 9 aa, BK Virus
FRPKIYLRK

SEQ ID NO: 61204 - protein, 15 aa, BK Virus
RQIDFRPKIYLRKSL

SEQ ID NO: 61205 - protein, 9 aa, BK Virus
FRPKIYLRK

SEQ ID NO: 61206 - protein, 15 aa, BK Virus
QIDFRPKIYLRKSLQ

SEQ ID NO: 61207 - protein, 9 aa, BK Virus
FRPKIYLRK

SEQ ID NO: 61208 - protein, 15 aa, BK Virus
IDFRPKIYLRKSLQN

SEQ ID NO: 61209 - protein, 9 aa, BK Virus
FRPKIYLRK

SEQ ID NO: 61210 - protein, 15 aa, BK Virus
LHCVVFNVPKRRYWL

SEQ ID NO: 61211 - protein, 9 aa, BK Virus
VVFNVPKRR

SEQ ID NO: 61212 - protein, 15 aa, BK Virus
HCVVFNVPKRRYWLF

SEQ ID NO: 61213 - protein, 9 aa, BK Virus
VVFNVPKRR

SEQ ID NO: 61214 - protein, 15 aa, BK Virus
FLHCVVFNVPKRRYW

SEQ ID NO: 61215 - protein, 9 aa, BK Virus
VVFNVPKRR

SEQ ID NO: 61216 - protein, 15 aa, BK Virus
DFLHCVVFNVPKRRY

SEQ ID NO: 61217 - protein, 9 aa, BK Virus
VVFNVPKRR

SEQ ID NO: 61218 - protein, 15 aa, BK Virus
DFRPKIYLRKSLQNS

SEQ ID NO: 61219 - protein, 9 aa, BK Virus
FRPKIYLRK

SEQ ID NO: 61220 - protein, 15 aa, BK Virus
FRPKIYLRKSLQNSE

SEQ ID NO: 61221 - protein, 9 aa, BK Virus
FRPKIYLRK

SEQ ID NO: 61222 - protein, 15 aa, BK Virus
KEHDFNPEEPEETKQ

SEQ ID NO: 61223 - protein, 9 aa, BK Virus
FNPEEPEET

SEQ ID NO: 61224 - protein, 15 aa, BK Virus
LKEHDFNPEEPEETK

SEQ ID NO: 61225 - protein, 9 aa, BK Virus
FNPEEPEET

SEQ ID NO: 61226 - protein, 15 aa, BK Virus
EHDFNPEEPEETKQV

SEQ ID NO: 61227 - protein, 9 aa, BK Virus
FNPEEPEET

SEQ ID NO: 61228 - protein, 15 aa, BK Virus
GLKEHDFNPEEPEET

SEQ ID NO: 61229 - protein, 9 aa, BK Virus
GLKEHDFNP

SEQ ID NO: 61230 - protein, 15 aa, BK Virus
HDFNPEEPEETKQVS

SEQ ID NO: 61231 - protein, 9 aa, BK Virus
FNPEEPEET

SEQ ID NO: 61232 - protein, 15 aa, BK Virus
FDFLHCVVFNVPKRR

SEQ ID NO: 61233 - protein, 9 aa, BK Virus
CVVFNVPKR

SEQ ID NO: 61234 - protein, 15 aa, BK Virus
CVVFNVPKRRYWLFK

SEQ ID NO: 61235 - protein, 9 aa, BK Virus
VVFNVPKRR

SEQ ID NO: 61236 - protein, 15 aa, BK Virus
TYGTEEWESWWSSFN

SEQ ID NO: 61237 - protein, 9 aa, BK Virus
TEEWESWWS

SEQ ID NO: 61238 - protein, 15 aa, BK Virus
YGTEEWESWWSSFNE

SEQ ID NO: 61239 - protein, 9 aa, BK Virus
WESWWSSFN

SEQ ID NO: 61240 - protein, 15 aa, BK Virus
EEWESWWSSFNEKWD

SEQ ID NO: 61241 - protein, 9 aa, BK Virus
WESWWSSFN

SEQ ID NO: 61242 - protein, 15 aa, BK Virus
TEEWESWWSSFNEKW

SEQ ID NO: 61243 - protein, 9 aa, BK Virus
WESWWSSFN

SEQ ID NO: 61244 - protein, 15 aa, BK Virus
GTEEWESWWSSFNEK

SEQ ID NO: 61245 - protein, 9 aa, BK Virus
WESWWSSFN

SEQ ID NO: 61246 - protein, 15 aa, BK Virus
KGFQCFKRPKTPPPK

SEQ ID NO: 61247 - protein, 9 aa, BK Virus
FQCFKRPKT

SEQ ID NO: 61248 - protein, 15 aa, BK Virus
EDKMKRMNTLYKKME

SEQ ID NO: 61249 - protein, 9 aa, BK Virus
MKRMNTLYK

SEQ ID NO: 61250 - protein, 15 aa, BK Virus
DKMKRMNTLYKKMEQ

SEQ ID NO: 61251 - protein, 9 aa, BK Virus
MKRMNTLYK

SEQ ID NO: 61252 - protein, 15 aa, BK Virus
DEDKMKRMNTLYKKM

SEQ ID NO: 61253 - protein, 9 aa, BK Virus
MKRMNTLYK

SEQ ID NO: 61254 - protein, 15 aa, BK Virus
VVFNVPKRRYWLFKG

SEQ ID NO: 61255 - protein, 9 aa, BK Virus
VVFNVPKRR

SEQ ID NO: 61256 - protein, 15 aa, BK Virus
GDEDKMKRMNTLYKK

SEQ ID NO: 61257 - protein, 9 aa, BK Virus
MKRMNTLYK

SEQ ID NO: 61258 - protein, 15 aa, BK Virus
HNIIFFLTPHRHRVS

SEQ ID NO: 61259 - protein, 9 aa, BK Virus
FFLTPHRHR

SEQ ID NO: 61260 - protein, 15 aa, BK Virus
GGDEDKMKRMNTLYK

SEQ ID NO: 61261 - protein, 9 aa, BK Virus
DKMKRMNTL

SEQ ID NO: 61262 - protein, 15 aa, BK Virus
GHNIIFFLTPHRHRV

SEQ ID NO: 61263 - protein, 9 aa, BK Virus
FFLTPHRHR

SEQ ID NO: 61264 - protein, 15 aa, BK Virus
NIIFFLTPHRHRVSA

SEQ ID NO: 61265 - protein, 9 aa, BK Virus
FFLTPHRHR

SEQ ID NO: 61266 - protein, 15 aa, BK Virus
TADSQHSTPPKKKRK

SEQ ID NO: 61267 - protein, 9 aa, BK Virus
QHSTPPKKK

SEQ ID NO: 61268 - protein, 15 aa, BK Virus
ADSQHSTPPKKKRKV

SEQ ID NO: 61269 - protein, 9 aa, BK Virus
QHSTPPKKK

SEQ ID NO: 61270 - protein, 15 aa, BK Virus
FNPEEPEETKQVSWK

SEQ ID NO: 61271 - protein, 9 aa, BK Virus
FNPEEPEET

SEQ ID NO: 61272 - protein, 15 aa, BK Virus
KRMNTLYKKMEQDVK

SEQ ID NO: 61273 - protein, 9 aa, BK Virus
KRMNTLYKK

SEQ ID NO: 61274 - protein, 15 aa, BK Virus
AAWGNLPLMRKAYLK

SEQ ID NO: 61275 - protein, 9 aa, BK Virus
WGNLPLMRK

SEQ ID NO: 61276 - protein, 15 aa, BK Virus
LVVLRQLSRQASVKV

SEQ ID NO: 61277 - protein, 9 aa, BK Virus
LRQLSRQAS

SEQ ID NO: 61278 - protein, 15 aa, BK Virus
VVLRQLSRQASVKVG

SEQ ID NO: 61279 - protein, 9 aa, BK Virus
LSRQASVKV

SEQ ID NO: 61280 - protein, 15 aa, BK Virus
VLRQLSRQASVKVGK

SEQ ID NO: 61281 - protein, 9 aa, BK Virus
LSRQASVKV

SEQ ID NO: 61282 - protein, 15 aa, BK Virus
LRQLSRQASVKVGKT

SEQ ID NO: 61283 - protein, 9 aa, BK Virus
LSRQASVKV

SEQ ID NO: 61284 - protein, 15 aa, BK Virus
PKNLVVLRQLSRQAS

SEQ ID NO: 61285 - protein, 9 aa, BK Virus
VLRQLSRQA

SEQ ID NO: 61286 - protein, 15 aa, BK Virus
NLVVLRQLSRQASVK

SEQ ID NO: 61287 - protein, 9 aa, BK Virus
VLRQLSRQA

SEQ ID NO: 61288 - protein, 15 aa, BK Virus
KNLVVLRQLSRQASV

SEQ ID NO: 61289 - protein, 9 aa, BK Virus
VLRQLSRQA

SEQ ID NO: 61290 - protein, 15 aa, BK Virus
RQLSRQASVKVGKTW

SEQ ID NO: 61291 - protein, 9 aa, BK Virus
LSRQASVKV

SEQ ID NO: 61292 - protein, 15 aa, BK Virus
LSRQASVKVGKTWTG

SEQ ID NO: 61293 - protein, 9 aa, BK Virus
LSRQASVKV

SEQ ID NO: 61294 - protein, 15 aa, BK Virus
ASVKVGKTWTGTKKR

SEQ ID NO: 61295 - protein, 9 aa, BK Virus
VKVGKTWTG

SEQ ID NO: 61296 - protein, 15 aa, BK Virus
QASVKVGKTWTGTKK

SEQ ID NO: 61297 - protein, 9 aa, BK Virus
VKVGKTWTG

SEQ ID NO: 61298 - protein, 15 aa, BK Virus
SRQASVKVGKTWTGT

SEQ ID NO: 61299 - protein, 9 aa, BK Virus
VKVGKTWTG

SEQ ID NO: 61300 - protein, 15 aa, BK Virus
RQASVKVGKTWTGTK

SEQ ID NO: 61301 - protein, 9 aa, BK Virus
VKVGKTWTG

SEQ ID NO: 61302 - protein, 15 aa, BK Virus
EPKNLVVLRQLSRQA

SEQ ID NO: 61303 - protein, 9 aa, BK Virus
PKNLVVLRQ

SEQ ID NO: 61304 - protein, 15 aa, BK Virus
QLSRQASVKVGKTWT

SEQ ID NO: 61305 - protein, 9 aa, BK Virus
LSRQASVKV

SEQ ID NO: 61306 - protein, 15 aa, BK Virus
SVKVGKTWTGTKKRA

SEQ ID NO: 61307 - protein, 9 aa, BK Virus
VKVGKTWTG

SEQ ID NO: 61308 - protein, 15 aa, BK Virus
VKVGKTWTGTKKRAQ

SEQ ID NO: 61309 - protein, 9 aa, BK Virus
VKVGKTWTG

SEQ ID NO: 61310 - protein, 15 aa, BK Virus
LVVLRQLSRQASVKV

SEQ ID NO: 61311 - protein, 9 aa, BK Virus
VLRQLSRQA

SEQ ID NO: 61312 - protein, 15 aa, BK Virus
VLRQLSRQASVKVGK

SEQ ID NO: 61313 - protein, 9 aa, BK Virus
LSRQASVKV

SEQ ID NO: 61314 - protein, 15 aa, BK Virus
VVLRQLSRQASVKVG

SEQ ID NO: 61315 - protein, 9 aa, BK Virus
LSRQASVKV

SEQ ID NO: 61316 - protein, 15 aa, BK Virus
LRQLSRQASVKVGKT

SEQ ID NO: 61317 - protein, 9 aa, BK Virus
LSRQASVKV

SEQ ID NO: 61318 - protein, 15 aa, BK Virus
RQLSRQASVKVGKTW

SEQ ID NO: 61319 - protein, 9 aa, BK Virus
LSRQASVKV

SEQ ID NO: 61320 - protein, 15 aa, BK Virus
DGKNKSTTALPAVKD

SEQ ID NO: 61321 - protein, 9 aa, BK Virus
NKSTTALPA

SEQ ID NO: 61322 - protein, 15 aa, BK Virus
GKNKSTTALPAVKDS

SEQ ID NO: 61323 - protein, 9 aa, BK Virus
TTALPAVKD

SEQ ID NO: 61324 - protein, 15 aa, BK Virus
KNKSTTALPAVKDSV

SEQ ID NO: 61325 - protein, 9 aa, BK Virus
TTALPAVKD

SEQ ID NO: 61326 - protein, 15 aa, BK Virus
NKSTTALPAVKDSVK

SEQ ID NO: 61327 - protein, 9 aa, BK Virus
TTALPAVKD

SEQ ID NO: 61328 - protein, 15 aa, BK Virus
LVVLRQLSRQASVKV

SEQ ID NO: 61329 - protein, 9 aa, BK Virus
LRQLSRQAS

SEQ ID NO: 61330 - protein, 15 aa, BK Virus
PKNLVVLRQLSRQAS

SEQ ID NO: 61331 - protein, 9 aa, BK Virus
PKNLVVLRQ

SEQ ID NO: 61332 - protein, 15 aa, BK Virus
KNLVVLRQLSRQASV

SEQ ID NO: 61333 - protein, 9 aa, BK Virus
LRQLSRQAS

SEQ ID NO: 61334 - protein, 15 aa, BK Virus
VVLRQLSRQASVKVG

SEQ ID NO: 61335 - protein, 9 aa, BK Virus
LRQLSRQAS

SEQ ID NO: 61336 - protein, 15 aa, BK Virus
NLVVLRQLSRQASVK

SEQ ID NO: 61337 - protein, 9 aa, BK Virus
LRQLSRQAS

SEQ ID NO: 61338 - protein, 15 aa, BK Virus
PKNLVVLRQLSRQAS

SEQ ID NO: 61339 - protein, 9 aa, BK Virus
VVLRQLSRQ

SEQ ID NO: 61340 - protein, 15 aa, BK Virus
LVVLRQLSRQASVKV

SEQ ID NO: 61341 - protein, 9 aa, BK Virus
LRQLSRQAS

SEQ ID NO: 61342 - protein, 15 aa, BK Virus
KNLVVLRQLSRQASV

SEQ ID NO: 61343 - protein, 9 aa, BK Virus
LRQLSRQAS

SEQ ID NO: 61344 - protein, 15 aa, BK Virus
VVLRQLSRQASVKVG

SEQ ID NO: 61345 - protein, 9 aa, BK Virus
LRQLSRQAS

SEQ ID NO: 61346 - protein, 15 aa, BK Virus
NLVVLRQLSRQASVK

SEQ ID NO: 61347 - protein, 9 aa, BK Virus
LRQLSRQAS

SEQ ID NO: 61348 - protein, 15 aa, BK Virus
CEPKNLVVLRQLSRQ

SEQ ID NO: 61349 - protein, 9 aa, BK Virus
LVVLRQLSR

SEQ ID NO: 61350 - protein, 15 aa, BK Virus
PKNLVVLRQLSRQAS

SEQ ID NO: 61351 - protein, 9 aa, BK Virus
LVVLRQLSR

SEQ ID NO: 61352 - protein, 15 aa, BK Virus
KNLVVLRQLSRQASV

SEQ ID NO: 61353 - protein, 9 aa, BK Virus
LVVLRQLSR

SEQ ID NO: 61354 - protein, 15 aa, BK Virus
EPKNLVVLRQLSRQA

SEQ ID NO: 61355 - protein, 9 aa, BK Virus
LVVLRQLSR

SEQ ID NO: 61356 - protein, 15 aa, BK Virus
CEPKNLVVLRQLSRQ

SEQ ID NO: 61357 - protein, 9 aa, BK Virus
LVVLRQLSR

SEQ ID NO: 61358 - protein, 15 aa, BK Virus
NLVVLRQLSRQASVK

SEQ ID NO: 61359 - protein, 9 aa, BK Virus
LVVLRQLSR

SEQ ID NO: 61360 - protein, 15 aa, BK Virus
LVVLRQLSRQASVKV

SEQ ID NO: 61361 - protein, 9 aa, BK Virus
LVVLRQLSR

SEQ ID NO: 61362 - protein, 15 aa, BK Virus
FCEPKNLVVLRQLSR

SEQ ID NO: 61363 - protein, 9 aa, BK Virus
NLVVLRQLS

SEQ ID NO: 61364 - protein, 15 aa, BK Virus
VVLRQLSRQASVKVG

SEQ ID NO: 61365 - protein, 9 aa, BK Virus
LRQLSRQAS

SEQ ID NO: 61366 - protein, 15 aa, BK Virus
RIFIFILELLLEFCR

SEQ ID NO: 61367 - protein, 9 aa, BK Virus
ILELLLEFC

SEQ ID NO: 61368 - protein, 9 aa, Lymphocytic choriomeningitis virus
SFSDAQSAL

SEQ ID NO: 61369 - protein, 8 aa, Lymphocytic choriomeningitis virus
GYCLTKWM

SEQ ID NO: 61370 - protein, 9 aa, Lymphocytic choriomeningitis virus
MYGLDGPDI

SEQ ID NO: 61371 - protein, 9 aa, Lymphocytic choriomeningitis virus
TFDHTLMSI

SEQ ID NO: 61372 - protein, 9 aa, Lymphocytic choriomeningitis virus
IVLIIITSI

SEQ ID NO: 61373 - protein, 9 aa, Lymphocytic choriomeningitis virus
VYNFATCGI

SEQ ID NO: 61374 - protein, 9 aa, Lymphocytic choriomeningitis virus
HYISMGKSG

SEQ ID NO: 61375 - protein, 9 aa, Lymphocytic choriomeningitis virus
NFATCGILA

SEQ ID NO: 61376 - protein, 9 aa, Lymphocytic choriomeningitis virus
SMGKSGLEL

SEQ ID NO: 61377 - protein, 9 aa, Lymphocytic choriomeningitis virus
TLMSIVSSL

SEQ ID NO: 61378 - protein, 9 aa, Lymphocytic choriomeningitis virus
QYNLSFSDA

SEQ ID NO: 61379 - protein, 9 aa, Lymphocytic choriomeningitis virus
CSQTSYQYL

SEQ ID NO: 61380 - protein, 9 aa, Lymphocytic choriomeningitis virus
MFEALPHII

SEQ ID NO: 61381 - protein, 9 aa, Lymphocytic choriomeningitis virus
IIITSIKAV

SEQ ID NO: 61382 - protein, 9 aa, Lymphocytic choriomeningitis virus
IYKGVYQFK

SEQ ID NO: 61383 - protein, 9 aa, Lymphocytic choriomeningitis virus
EFDMSHLNL

SEQ ID NO: 61384 - protein, 9 aa, Lymphocytic choriomeningitis virus
SYQYLIIQN

SEQ ID NO: 61385 - protein, 9 aa, Lymphocytic choriomeningitis virus
GILALVSFL

SEQ ID NO: 61386 - protein, 9 aa, Lymphocytic choriomeningitis virus
LALVSFLFL

SEQ ID NO: 61387 - protein, 9 aa, Lymphocytic choriomeningitis virus
KGVYQFKSV

SEQ ID NO: 61388 - protein, 9 aa, Lymphocytic choriomeningitis virus
SVNNSHHYI

SEQ ID NO: 61389 - protein, 9 aa, Lymphocytic choriomeningitis virus
IVSSLHLSI

SEQ ID NO: 61390 - protein, 9 aa, Lymphocytic choriomeningitis virus
KYMRSGWGW

SEQ ID NO: 61391 - protein, 9 aa, Lymphocytic choriomeningitis virus
SQTSYQYLI

SEQ ID NO: 61392 - protein, 9 aa, Lymphocytic choriomeningitis virus
QIVTMFEAL

SEQ ID NO: 61393 - protein, 9 aa, Lymphocytic choriomeningitis virus
INIVIIVLI

SEQ ID NO: 61394 - protein, 9 aa, Lymphocytic choriomeningitis virus
LTMPNACSV

SEQ ID NO: 61395 - protein, 9 aa, Lymphocytic choriomeningitis virus
NYKPVSCDF

SEQ ID NO: 61396 - protein, 9 aa, Lymphocytic choriomeningitis virus
TYAGPFRIS

SEQ ID NO: 61397 - protein, 9 aa, Lymphocytic choriomeningitis virus
VESPGGYCL

SEQ ID NO: 61398 - protein, 9 aa, Lymphocytic choriomeningitis virus
YCLTKWMIL

SEQ ID NO: 61399 - protein, 9 aa, Lymphocytic choriomeningitis virus
KWMILAAEL

SEQ ID NO: 61400 - protein, 9 aa, Lymphocytic choriomeningitis virus
SFLFLAGKS

SEQ ID NO: 61401 - protein, 9 aa, Lymphocytic choriomeningitis virus
FAQEKTKFL

SEQ ID NO: 61402 - protein, 9 aa, Lymphocytic choriomeningitis virus
TMFEALPHI

SEQ ID NO: 61403 - protein, 9 aa, Lymphocytic choriomeningitis virus
HIIDEVINI

SEQ ID NO: 61404 - protein, 9 aa, Lymphocytic choriomeningitis virus
IVIIVLIII

SEQ ID NO: 61405 - protein, 9 aa, Lymphocytic choriomeningitis virus
SVEFDMSHL

SEQ ID NO: 61406 - protein, 9 aa, Lymphocytic choriomeningitis virus
LTFTNDSIL

SEQ ID NO: 61407 - protein, 9 aa, Lymphocytic choriomeningitis virus
MSIVSSLHL

SEQ ID NO: 61408 - protein, 9 aa, Lymphocytic choriomeningitis virus
RGNSNYKPV

SEQ ID NO: 61409 - protein, 9 aa, Lymphocytic choriomeningitis virus
NGITIQYNL

SEQ ID NO: 61410 - protein, 9 aa, Lymphocytic choriomeningitis virus
LSFSDAQSA

SEQ ID NO: 61411 - protein, 9 aa, Lymphocytic choriomeningitis virus
TWENHCTYA

SEQ ID NO: 61412 - protein, 9 aa, Lymphocytic choriomeningitis virus
LFAQEKTKF

SEQ ID NO: 61413 - protein, 9 aa, Lymphocytic choriomeningitis virus
KTKFLTRRL

SEQ ID NO: 61414 - protein, 9 aa, Lymphocytic choriomeningitis virus
KFLTRRLAG

SEQ ID NO: 61415 - protein, 9 aa, Lymphocytic choriomeningitis virus
WTLSDSSGV

SEQ ID NO: 61416 - protein, 9 aa, Lymphocytic choriomeningitis virus
IIDEVINIV

SEQ ID NO: 61417 - protein, 9 aa, Lymphocytic choriomeningitis virus
IDEVINIVI

SEQ ID NO: 61418 - protein, 9 aa, Lymphocytic choriomeningitis virus
DEVINIVII

SEQ ID NO: 61419 - protein, 9 aa, Lymphocytic choriomeningitis virus
VINIVIIVL

SEQ ID NO: 61420 - protein, 9 aa, Lymphocytic choriomeningitis virus
NIVIIVLII

SEQ ID NO: 61421 - protein, 9 aa, Lymphocytic choriomeningitis virus
SIKAVYNFA

SEQ ID NO: 61422 - protein, 9 aa, Lymphocytic choriomeningitis virus
LFLAGKSCG

SEQ ID NO: 61423 - protein, 9 aa, Lymphocytic choriomeningitis virus
YISMGKSGL

SEQ ID NO: 61424 - protein, 9 aa, Lymphocytic choriomeningitis virus
ELTFTNDSI

SEQ ID NO: 61425 - protein, 9 aa, Lymphocytic choriomeningitis virus
HNHCNLTSA

SEQ ID NO: 61426 - protein, 9 aa, Lymphocytic choriomeningitis virus
NKKTFDHTL

SEQ ID NO: 61427 - protein, 9 aa, Lymphocytic choriomeningitis virus
FDHTLMSIV

SEQ ID NO: 61428 - protein, 9 aa, Lymphocytic choriomeningitis virus
CDFNNGITI

SEQ ID NO: 61429 - protein, 9 aa, Lymphocytic choriomeningitis virus
QYLIIQNRT

SEQ ID NO: 61430 - protein, 9 aa, Lymphocytic choriomeningitis virus
PSREMGQIV

SEQ ID NO: 61431 - protein, 9 aa, Lymphocytic choriomeningitis virus
YNFATCGIL

SEQ ID NO: 61432 - protein, 9 aa, Lymphocytic choriomeningitis virus
FATCGILAL

SEQ ID NO: 61433 - protein, 9 aa, Lymphocytic choriomeningitis virus
ATCGILALV

SEQ ID NO: 61434 - protein, 9 aa, Lymphocytic choriomeningitis virus
DGPDIYKGV

SEQ ID NO: 61435 - protein, 9 aa, Lymphocytic choriomeningitis virus
VYQFKSVEF

SEQ ID NO: 61436 - protein, 9 aa, Lymphocytic choriomeningitis virus
QFKSVEFDM

SEQ ID NO: 61437 - protein, 9 aa, Lymphocytic choriomeningitis virus
ILNHNHCNL

SEQ ID NO: 61438 - protein, 9 aa, Lymphocytic choriomeningitis virus
DFNNGITIQ

SEQ ID NO: 61439 - protein, 9 aa, Lymphocytic choriomeningitis virus
CKTFRGRVL

SEQ ID NO: 61440 - protein, 9 aa, Lymphocytic choriomeningitis virus
TFRGRVLDM

SEQ ID NO: 61441 - protein, 9 aa, Lymphocytic choriomeningitis virus
RVLDMFRTA

SEQ ID NO: 61442 - protein, 9 aa, Lymphocytic choriomeningitis virus
LAGTFTWTL

SEQ ID NO: 61443 - protein, 9 aa, Lymphocytic choriomeningitis virus
LPSREMGQI

SEQ ID NO: 61444 - protein, 9 aa, Lymphocytic choriomeningitis virus
GQIVTMFEA

SEQ ID NO: 61445 - protein, 9 aa, Lymphocytic choriomeningitis virus
ALPHIIDEV

SEQ ID NO: 61446 - protein, 9 aa, Lymphocytic choriomeningitis virus
LPHIIDEVI

SEQ ID NO: 61447 - protein, 9 aa, Lymphocytic choriomeningitis virus
EVINIVIIV

SEQ ID NO: 61448 - protein, 9 aa, Lymphocytic choriomeningitis virus
ALVSFLFLA

SEQ ID NO: 61449 - protein, 9 aa, Lymphocytic choriomeningitis virus
GKSCGMYGL

SEQ ID NO: 61450 - protein, 9 aa, Lymphocytic choriomeningitis virus
SIVSSLHLS

SEQ ID NO: 61451 - protein, 9 aa, Lymphocytic choriomeningitis virus
VSCDFNNGI

SEQ ID NO: 61452 - protein, 9 aa, Lymphocytic choriomeningitis virus
SDAQSALSQ

SEQ ID NO: 61453 - protein, 9 aa, Lymphocytic choriomeningitis virus
SALSQCKTF

SEQ ID NO: 61454 - protein, 9 aa, Lymphocytic choriomeningitis virus
QCKTFRGRV

SEQ ID NO: 61455 - protein, 9 aa, Lymphocytic choriomeningitis virus
TTWCSQTSY

SEQ ID NO: 61456 - protein, 9 aa, Lymphocytic choriomeningitis virus
QTSYQYLII

SEQ ID NO: 61457 - protein, 9 aa, Lymphocytic choriomeningitis virus
CTYAGPFRI

SEQ ID NO: 61458 - protein, 9 aa, Lymphocytic choriomeningitis virus
FRISRVLFA

SEQ ID NO: 61459 - protein, 9 aa, Lymphocytic choriomeningitis virus
TFTWTLSDS

SEQ ID NO: 61460 - protein, 9 aa, Lymphocytic choriomeningitis virus
CNLTSAFNK

SEQ ID NO: 61461 - protein, 9 aa, Lymphocytic choriomeningitis virus
SAFNKKTFD

SEQ ID NO: 61462 - protein, 9 aa, Lymphocytic choriomeningitis virus
MFRTAFGGK

SEQ ID NO: 61463 - protein, 9 aa, Lymphocytic choriomeningitis virus
SGWGWAGSD

SEQ ID NO: 61464 - protein, 9 aa, Lymphocytic choriomeningitis virus
AGPFRISRV

SEQ ID NO: 61465 - protein, 9 aa, Lymphocytic choriomeningitis virus
GPFRISRVL

SEQ ID NO: 61466 - protein, 9 aa, Lymphocytic choriomeningitis virus
TKFLTRRLA

SEQ ID NO: 61467 - protein, 9 aa, Lymphocytic choriomeningitis virus
RLAGTFTWT

SEQ ID NO: 61468 - protein, 9 aa, Lymphocytic choriomeningitis virus
SDSSGVESP

SEQ ID NO: 61469 - protein, 8 aa, Lymphocytic choriomeningitis virus
FTNDSILN

SEQ ID NO: 61470 - protein, 9 aa, Lymphocytic choriomeningitis virus
AFGGKYMRS

SEQ ID NO: 61471 - protein, 9 aa, Lymphocytic choriomeningitis virus
YMRSGWGWA

SEQ ID NO: 61472 - protein, 9 aa, Lymphocytic choriomeningitis virus
PFRISRVLF

SEQ ID NO: 61473 - protein, 9 aa, Lymphocytic choriomeningitis virus
TRRLAGTFT

SEQ ID NO: 61474 - protein, 9 aa, Lymphocytic choriomeningitis virus
LTKWMILAA

SEQ ID NO: 61475 - protein, 9 aa, Lymphocytic choriomeningitis virus
EALPHIIDE

SEQ ID NO: 61476 - protein, 9 aa, Lymphocytic choriomeningitis virus
SHLNLTMPN

SEQ ID NO: 61477 - protein, 9 aa, Lymphocytic choriomeningitis virus
SGLELTFTN

SEQ ID NO: 61478 - protein, 9 aa, Lymphocytic choriomeningitis virus
HTLMSIVSS

SEQ ID NO: 61479 - protein, 9 aa, Lymphocytic choriomeningitis virus
AGSDGKTTW

SEQ ID NO: 61480 - protein, 9 aa, Lymphocytic choriomeningitis virus
SRVLFAQEK

SEQ ID NO: 61481 - protein, 9 aa, Lymphocytic choriomeningitis virus
LSDSSGVES

SEQ ID NO: 61482 - protein, 9 aa, Lymphocytic choriomeningitis virus
SGVESPGGY

SEQ ID NO: 61483 - protein, 9 aa, Lymphocytic choriomeningitis virus
CLTKWMILA

SEQ ID NO: 61484 - protein, 9 aa, Lymphocytic choriomeningitis virus
LIIITSIKA

SEQ ID NO: 61485 - protein, 9 aa, Lymphocytic choriomeningitis virus
FLFLAGKSC

SEQ ID NO: 61486 - protein, 9 aa, Lymphocytic choriomeningitis virus
AGKSCGMYG

SEQ ID NO: 61487 - protein, 9 aa, Lymphocytic choriomeningitis virus
HLNLTMPNA

SEQ ID NO: 61488 - protein, 9 aa, Lymphocytic choriomeningitis virus
NACSVNNSH

SEQ ID NO: 61489 - protein, 9 aa, Lymphocytic choriomeningitis virus
SILNHNHCN

SEQ ID NO: 61490 - protein, 9 aa, Lymphocytic choriomeningitis virus
TSAFNKKTF

SEQ ID NO: 61491 - protein, 9 aa, Lymphocytic choriomeningitis virus
AFNKKTFDH

SEQ ID NO: 61492 - protein, 9 aa, Lymphocytic choriomeningitis virus
KKTFDHTLM

SEQ ID NO: 61493 - protein, 9 aa, Lymphocytic choriomeningitis virus
SSLHLSIRG

SEQ ID NO: 61494 - protein, 9 aa, Lymphocytic choriomeningitis virus
KPVSCDFNN

SEQ ID NO: 61495 - protein, 9 aa, Lymphocytic choriomeningitis virus
DAQSALSQC

SEQ ID NO: 61496 - protein, 9 aa, Lymphocytic choriomeningitis virus
ALSQCKTFR

SEQ ID NO: 61497 - protein, 9 aa, Lymphocytic choriomeningitis virus
RTAFGGKYM

SEQ ID NO: 61498 - protein, 9 aa, Lymphocytic choriomeningitis virus
TAFGGKYMR

SEQ ID NO: 61499 - protein, 9 aa, Lymphocytic choriomeningitis virus
WAGSDGKTT

SEQ ID NO: 61500 - protein, 9 aa, Lymphocytic choriomeningitis virus
GSDGKTTWC

SEQ ID NO: 61501 - protein, 9 aa, Lymphocytic choriomeningitis virus
DGKTTWCSQ

SEQ ID NO: 61502 - protein, 9 aa, Lymphocytic choriomeningitis virus
TWCSQTSYQ

SEQ ID NO: 61503 - protein, 9 aa, Lymphocytic choriomeningitis virus
TWTLSDSSG

SEQ ID NO: 61504 - protein, 9 aa, Lymphocytic choriomeningitis virus
EMGQIVTMF

SEQ ID NO: 61505 - protein, 9 aa, Lymphocytic choriomeningitis virus
IITSIKAVY

SEQ ID NO: 61506 - protein, 9 aa, Lymphocytic choriomeningitis virus
TSIKAVYNF

SEQ ID NO: 61507 - protein, 9 aa, Lymphocytic choriomeningitis virus
AVYNFATCG

SEQ ID NO: 61508 - protein, 9 aa, Lymphocytic choriomeningitis virus
KSCGMYGLD

SEQ ID NO: 61509 - protein, 9 aa, Lymphocytic choriomeningitis virus
KSVEFDMSH

SEQ ID NO: 61510 - protein, 9 aa, Lymphocytic choriomeningitis virus
LNLTMPNAC

SEQ ID NO: 61511 - protein, 9 aa, Lymphocytic choriomeningitis virus
MGKSGLELT

SEQ ID NO: 61512 - protein, 9 aa, Lymphocytic choriomeningitis virus
KSGLELTFT

SEQ ID NO: 61513 - protein, 9 aa, Lymphocytic choriomeningitis virus
SLHLSIRGN

SEQ ID NO: 61514 - protein, 9 aa, Lymphocytic choriomeningitis virus
LHLSIRGNS

SEQ ID NO: 61515 - protein, 9 aa, Lymphocytic choriomeningitis virus
SIRGNSNYK

SEQ ID NO: 61516 - protein, 9 aa, Lymphocytic choriomeningitis virus
SNYKPVSCD

SEQ ID NO: 61517 - protein, 9 aa, Lymphocytic choriomeningitis virus
TIQYNLSFS

SEQ ID NO: 61518 - protein, 9 aa, Lymphocytic choriomeningitis virus
GWAGSDGKT

SEQ ID NO: 61519 - protein, 9 aa, Lymphocytic choriomeningitis virus
LIIQNRTWE

SEQ ID NO: 61520 - protein, 9 aa, Lymphocytic choriomeningitis virus
RVLFAQEKT

SEQ ID NO: 61521 - protein, 9 aa, Lymphocytic choriomeningitis virus
AGTFTWTLS

SEQ ID NO: 61522 - protein, 9 aa, Lymphocytic choriomeningitis virus
DSSGVESPG

SEQ ID NO: 61523 - protein, 9 aa, Lymphocytic choriomeningitis virus
GVESPGGYC

SEQ ID NO: 61524 - protein, 9 aa, Lymphocytic choriomeningitis virus
SPGGYCLTK

SEQ ID NO: 61525 - protein, 9 aa, Lymphocytic choriomeningitis virus
WMILAAELK

SEQ ID NO: 61526 - protein, 9 aa, Lymphocytic choriomeningitis virus
TLPSREMGQ

SEQ ID NO: 61527 - protein, 9 aa, Lymphocytic choriomeningitis virus
REMGQIVTM

SEQ ID NO: 61528 - protein, 9 aa, Lymphocytic choriomeningitis virus
VIIVLIIIT

SEQ ID NO: 61529 - protein, 9 aa, Lymphocytic choriomeningitis virus
KAVYNFATC

SEQ ID NO: 61530 - protein, 9 aa, Lymphocytic choriomeningitis virus
TCGILALVS

SEQ ID NO: 61531 - protein, 9 aa, Lymphocytic choriomeningitis virus
SCGMYGLDG

SEQ ID NO: 61532 - protein, 9 aa, Lymphocytic choriomeningitis virus
YGLDGPDIY

SEQ ID NO: 61533 - protein, 9 aa, Lymphocytic choriomeningitis virus
LDGPDIYKG

SEQ ID NO: 61534 - protein, 9 aa, Lymphocytic choriomeningitis virus
PDIYKGVYQ

SEQ ID NO: 61535 - protein, 9 aa, Lymphocytic choriomeningitis virus
YQFKSVEFD

SEQ ID NO: 61536 - protein, 9 aa, Lymphocytic choriomeningitis virus
TMPNACSVN

SEQ ID NO: 61537 - protein, 9 aa, Lymphocytic choriomeningitis virus
PNACSVNNS

SEQ ID NO: 61538 - protein, 9 aa, Lymphocytic choriomeningitis virus
GLELTFTND

SEQ ID NO: 61539 - protein, 9 aa, Lymphocytic choriomeningitis virus
LELTFTNDS

SEQ ID NO: 61540 - protein, 9 aa, Lymphocytic choriomeningitis virus
FTNDSILNH

SEQ ID NO: 61541 - protein, 9 aa, Lymphocytic choriomeningitis virus
TNDSILNHN

SEQ ID NO: 61542 - protein, 9 aa, Lymphocytic choriomeningitis virus
ITIQYNLSF

SEQ ID NO: 61543 - protein, 9 aa, Lymphocytic choriomeningitis virus
SQCKTFRGR

SEQ ID NO: 61544 - protein, 9 aa, Lymphocytic choriomeningitis virus
MRSGWGWAG

SEQ ID NO: 61545 - protein, 9 aa, Lymphocytic choriomeningitis virus
GWGWAGSDG

SEQ ID NO: 61546 - protein, 9 aa, Lymphocytic choriomeningitis virus
SDGKTTWCS

SEQ ID NO: 61547 - protein, 9 aa, Lymphocytic choriomeningitis virus
IIQNRTWEN

SEQ ID NO: 61548 - protein, 9 aa, Lymphocytic choriomeningitis virus
NHCTYAGPF

SEQ ID NO: 61549 - protein, 9 aa, Lymphocytic choriomeningitis virus
YAGPFRISR

SEQ ID NO: 61550 - protein, 9 aa, Lymphocytic choriomeningitis virus
AQEKTKFLT

SEQ ID NO: 61551 - protein, 9 aa, Lymphocytic choriomeningitis virus
RRLAGTFTW

SEQ ID NO: 61552 - protein, 9 aa, Lymphocytic choriomeningitis virus
GTFTWTLSD

SEQ ID NO: 61553 - protein, 9 aa, Lymphocytic choriomeningitis virus
FTWTLSDSS

SEQ ID NO: 61554 - protein, 9 aa, Lymphocytic choriomeningitis virus
TLSDSSGVE

SEQ ID NO: 61555 - protein, 9 aa, Lymphocytic choriomeningitis virus
PGGYCLTKW

SEQ ID NO: 61556 - protein, 9 aa, Lymphocytic choriomeningitis virus
MILAAELKC

SEQ ID NO: 61557 - protein, 9 aa, Lymphocytic choriomeningitis virus
MGQIVTMFE

SEQ ID NO: 61558 - protein, 9 aa, Lymphocytic choriomeningitis virus
IIVLIIITS

SEQ ID NO: 61559 - protein, 9 aa, Lymphocytic choriomeningitis virus
ITSIKAVYN

SEQ ID NO: 61560 - protein, 9 aa, Lymphocytic choriomeningitis virus
IKAVYNFAT

SEQ ID NO: 61561 - protein, 9 aa, Lymphocytic choriomeningitis virus
CGILALVSF

SEQ ID NO: 61562 - protein, 9 aa, Lymphocytic choriomeningitis virus
ILALVSFLF

SEQ ID NO: 61563 - protein, 9 aa, Lymphocytic choriomeningitis virus
GMYGLDGPD

SEQ ID NO: 61564 - protein, 9 aa, Lymphocytic choriomeningitis virus
GLDGPDIYK

SEQ ID NO: 61565 - protein, 9 aa, Lymphocytic choriomeningitis virus
FDMSHLNLT

SEQ ID NO: 61566 - protein, 9 aa, Lymphocytic choriomeningitis virus
MSHLNLTMP

SEQ ID NO: 61567 - protein, 9 aa, Lymphocytic choriomeningitis virus
ISMGKSGLE

SEQ ID NO: 61568 - protein, 9 aa, Lymphocytic choriomeningitis virus
GKSGLELTF

SEQ ID NO: 61569 - protein, 9 aa, Lymphocytic choriomeningitis virus
NLTSAFNKK

SEQ ID NO: 61570 - protein, 9 aa, Lymphocytic choriomeningitis virus
KTFDHTLMS

SEQ ID NO: 61571 - protein, 9 aa, Lymphocytic choriomeningitis virus
HLSIRGNSN

SEQ ID NO: 61572 - protein, 9 aa, Lymphocytic choriomeningitis virus
IRGNSNYKP

SEQ ID NO: 61573 - protein, 9 aa, Lymphocytic choriomeningitis virus
YKPVSCDFN

SEQ ID NO: 61574 - protein, 9 aa, Lymphocytic choriomeningitis virus
NNGITIQYN

SEQ ID NO: 61575 - protein, 9 aa, Lymphocytic choriomeningitis virus
IQYNLSFSD

SEQ ID NO: 61576 - protein, 9 aa, Lymphocytic choriomeningitis virus
YNLSFSDAQ

SEQ ID NO: 61577 - protein, 9 aa, Lymphocytic choriomeningitis virus
KTFRGRVLD

SEQ ID NO: 61578 - protein, 9 aa, Lymphocytic choriomeningitis virus
RGRVLDMFR

SEQ ID NO: 61579 - protein, 9 aa, Lymphocytic choriomeningitis virus
DMFRTAFGG

SEQ ID NO: 61580 - protein, 9 aa, Lymphocytic choriomeningitis virus
GKTTWCSQT

SEQ ID NO: 61581 - protein, 9 aa, Lymphocytic choriomeningitis virus
IQNRTWENH

SEQ ID NO: 61582 - protein, 9 aa, Lymphocytic choriomeningitis virus
HCTYAGPFR

SEQ ID NO: 61583 - protein, 9 aa, Lymphocytic choriomeningitis virus
RISRVLFAQ

SEQ ID NO: 61584 - protein, 9 aa, Lymphocytic choriomeningitis virus
ISRVLFAQE

SEQ ID NO: 61585 - protein, 9 aa, Lymphocytic choriomeningitis virus
QEKTKFLTR

SEQ ID NO: 61586 - protein, 9 aa, Lymphocytic choriomeningitis virus
EKTKFLTRR

SEQ ID NO: 61587 - protein, 9 aa, Lymphocytic choriomeningitis virus
LTRRLAGTF

SEQ ID NO: 61588 - protein, 9 aa, Lymphocytic choriomeningitis virus
SSGVESPGG

SEQ ID NO: 61589 - protein, 9 aa, Lymphocytic choriomeningitis virus
ESPGGYCLT

SEQ ID NO: 61590 - protein, 9 aa, Lymphocytic choriomeningitis virus
GGYCLTKWM

SEQ ID NO: 61591 - protein, 9 aa, Lymphocytic choriomeningitis virus
SREMGQIVT

SEQ ID NO: 61592 - protein, 9 aa, Lymphocytic choriomeningitis virus
FLAGKSCGM

SEQ ID NO: 61593 - protein, 9 aa, Lymphocytic choriomeningitis virus
LAGKSCGMY

SEQ ID NO: 61594 - protein, 9 aa, Lymphocytic choriomeningitis virus
GVYQFKSVE

SEQ ID NO: 61595 - protein, 9 aa, Lymphocytic choriomeningitis virus
ACSVNNSHH

SEQ ID NO: 61596 - protein, 9 aa, Lymphocytic choriomeningitis virus
VNNSHHYIS

SEQ ID NO: 61597 - protein, 9 aa, Lymphocytic choriomeningitis virus
NNSHHYISM

SEQ ID NO: 61598 - protein, 9 aa, Lymphocytic choriomeningitis virus
NSHHYISMG

SEQ ID NO: 61599 - protein, 9 aa, Lymphocytic choriomeningitis virus
SHHYISMGK

SEQ ID NO: 61600 - protein, 9 aa, Lymphocytic choriomeningitis virus
NHCNLTSAF

SEQ ID NO: 61601 - protein, 9 aa, Lymphocytic choriomeningitis virus
FNKKTFDHT

SEQ ID NO: 61602 - protein, 9 aa, Lymphocytic choriomeningitis virus
LMSIVSSLH

SEQ ID NO: 61603 - protein, 9 aa, Lymphocytic choriomeningitis virus
LSIRGNSNY

SEQ ID NO: 61604 - protein, 9 aa, Lymphocytic choriomeningitis virus
GNSNYKPVS

SEQ ID NO: 61605 - protein, 9 aa, Lymphocytic choriomeningitis virus
NSNYKPVSC

SEQ ID NO: 61606 - protein, 9 aa, Lymphocytic choriomeningitis virus
SCDFNNGIT

SEQ ID NO: 61607 - protein, 9 aa, Lymphocytic choriomeningitis virus
FNNGITIQY

SEQ ID NO: 61608 - protein, 9 aa, Lymphocytic choriomeningitis virus
QSALSQCKT

SEQ ID NO: 61609 - protein, 9 aa, Lymphocytic choriomeningitis virus
LSQCKTFRG

SEQ ID NO: 61610 - protein, 9 aa, Lymphocytic choriomeningitis virus
FRGRVLDMF

SEQ ID NO: 61611 - protein, 9 aa, Lymphocytic choriomeningitis virus
VLDMFRTAF

SEQ ID NO: 61612 - protein, 9 aa, Lymphocytic choriomeningitis virus
FGGKYMRSG

SEQ ID NO: 61613 - protein, 9 aa, Lymphocytic choriomeningitis virus
GGKYMRSGW

SEQ ID NO: 61614 - protein, 9 aa, Lymphocytic choriomeningitis virus
KTTWCSQTS

SEQ ID NO: 61615 - protein, 9 aa, Lymphocytic choriomeningitis virus
TSYQYLIIQ

SEQ ID NO: 61616 - protein, 9 aa, Lymphocytic choriomeningitis virus
QNRTWENHC

SEQ ID NO: 61617 - protein, 9 aa, Lymphocytic choriomeningitis virus
VLFAQEKTK

SEQ ID NO: 61618 - protein, 9 aa, Lymphocytic choriomeningitis virus
VTMFEALPH

SEQ ID NO: 61619 - protein, 9 aa, Lymphocytic choriomeningitis virus
VLIIITSIK

SEQ ID NO: 61620 - protein, 9 aa, Lymphocytic choriomeningitis virus
GPDIYKGVY

SEQ ID NO: 61621 - protein, 9 aa, Lymphocytic choriomeningitis virus
DIYKGVYQF

SEQ ID NO: 61622 - protein, 9 aa, Lymphocytic choriomeningitis virus
YKGVYQFKS

SEQ ID NO: 61623 - protein, 9 aa, Lymphocytic choriomeningitis virus
FKSVEFDMS

SEQ ID NO: 61624 - protein, 9 aa, Lymphocytic choriomeningitis virus
VEFDMSHLN

SEQ ID NO: 61625 - protein, 9 aa, Lymphocytic choriomeningitis virus
DMSHLNLTM

SEQ ID NO: 61626 - protein, 9 aa, Lymphocytic choriomeningitis virus
CSVNNSHHY

SEQ ID NO: 61627 - protein, 9 aa, Lymphocytic choriomeningitis virus
HHYISMGKS

SEQ ID NO: 61628 - protein, 9 aa, Lymphocytic choriomeningitis virus
LNHNHCNLT

SEQ ID NO: 61629 - protein, 9 aa, Lymphocytic choriomeningitis virus
LTSAFNKKT

SEQ ID NO: 61630 - protein, 9 aa, Lymphocytic choriomeningitis virus
NLSFSDAQS

SEQ ID NO: 61631 - protein, 9 aa, Lymphocytic choriomeningitis virus
AQSALSQCK

SEQ ID NO: 61632 - protein, 9 aa, Lymphocytic choriomeningitis virus
GRVLDMFRT

SEQ ID NO: 61633 - protein, 9 aa, Lymphocytic choriomeningitis virus
FRTAFGGKY

SEQ ID NO: 61634 - protein, 9 aa, Lymphocytic choriomeningitis virus
RSGWGWAGS

SEQ ID NO: 61635 - protein, 9 aa, Lymphocytic choriomeningitis virus
YQYLIIQNR

SEQ ID NO: 61636 - protein, 9 aa, Lymphocytic choriomeningitis virus
RTWENHCTY

SEQ ID NO: 61637 - protein, 9 aa, Lymphocytic choriomeningitis virus
ENHCTYAGP

SEQ ID NO: 61638 - protein, 9 aa, Lymphocytic choriomeningitis virus
TKWMILAAE

SEQ ID NO: 61639 - protein, 9 aa, Lymphocytic choriomeningitis virus
IVTMFEALP

SEQ ID NO: 61640 - protein, 9 aa, Lymphocytic choriomeningitis virus
FEALPHIID

SEQ ID NO: 61641 - protein, 9 aa, Lymphocytic choriomeningitis virus
PHIIDEVIN

SEQ ID NO: 61642 - protein, 9 aa, Lymphocytic choriomeningitis virus
LVSFLFLAG

SEQ ID NO: 61643 - protein, 9 aa, Lymphocytic choriomeningitis virus
CGMYGLDGP

SEQ ID NO: 61644 - protein, 9 aa, Lymphocytic choriomeningitis virus
NDSILNHNH

SEQ ID NO: 61645 - protein, 9 aa, Lymphocytic choriomeningitis virus
DSILNHNHC

SEQ ID NO: 61646 - protein, 9 aa, Lymphocytic choriomeningitis virus
NHNHCNLTS

SEQ ID NO: 61647 - protein, 9 aa, Lymphocytic choriomeningitis virus
VSSLHLSIR

SEQ ID NO: 61648 - protein, 9 aa, Lymphocytic choriomeningitis virus
PVSCDFNNG

SEQ ID NO: 61649 - protein, 9 aa, Lymphocytic choriomeningitis virus
GITIQYNLS

SEQ ID NO: 61650 - protein, 9 aa, Lymphocytic choriomeningitis virus
FSDAQSALS

SEQ ID NO: 61651 - protein, 9 aa, Lymphocytic choriomeningitis virus
WCSQTSYQY

SEQ ID NO: 61652 - protein, 9 aa, Lymphocytic choriomeningitis virus
YLIIQNRTW

SEQ ID NO: 61653 - protein, 9 aa, Lymphocytic choriomeningitis virus
NRTWENHCT

SEQ ID NO: 61654 - protein, 9 aa, Lymphocytic choriomeningitis virus
WENHCTYAG

SEQ ID NO: 61655 - protein, 9 aa, Lymphocytic choriomeningitis virus
FLTRRLAGT

SEQ ID NO: 61656 - protein, 9 aa, Lymphocytic choriomeningitis virus
NLTMPNACS

SEQ ID NO: 61657 - protein, 9 aa, Lymphocytic choriomeningitis virus
MPNACSVNN

SEQ ID NO: 61658 - protein, 9 aa, Lymphocytic choriomeningitis virus
HCNLTSAFN

SEQ ID NO: 61659 - protein, 9 aa, Lymphocytic choriomeningitis virus
LDMFRTAFG

SEQ ID NO: 61660 - protein, 9 aa, Lymphocytic choriomeningitis virus
WGWAGSDGK

SEQ ID NO: 61661 - protein, 9 aa, Lymphocytic choriomeningitis virus
VSFLFLAGK

SEQ ID NO: 61662 - protein, 9 aa, Lymphocytic choriomeningitis virus
DHTLMSIVS

SEQ ID NO: 61663 - protein, 9 aa, Lymphocytic choriomeningitis virus
GKYMRSGWG

SEQ ID NO: 61664 - protein, 9 aa, Homo Sapiens
QLFEELQEL

SEQ ID NO: 61665 - protein, 9 aa, Lymphocytic choriomeningitis virus
SFSDAQSAL

SEQ ID NO: 61666 - protein, 9 aa, Lymphocytic choriomeningitis virus
GYCLTKWMI

SEQ ID NO: 61667 - protein, 9 aa, Lymphocytic choriomeningitis virus
MYGLDGPDI

SEQ ID NO: 61668 - protein, 9 aa, Lymphocytic choriomeningitis virus
TFDHTLMSI

SEQ ID NO: 61669 - protein, 9 aa, Lymphocytic choriomeningitis virus
IVLIIITSI

SEQ ID NO: 61670 - protein, 9 aa, Lymphocytic choriomeningitis virus
VYNFATCGI

SEQ ID NO: 61671 - protein, 9 aa, Lymphocytic choriomeningitis virus
HYISMGKSG

SEQ ID NO: 61672 - protein, 9 aa, Lymphocytic choriomeningitis virus
NFATCGILA

SEQ ID NO: 61673 - protein, 9 aa, Lymphocytic choriomeningitis virus
SMGKSGLEL

SEQ ID NO: 61674 - protein, 9 aa, Lymphocytic choriomeningitis virus
TLMSIVSSL

SEQ ID NO: 61675 - protein, 9 aa, Lymphocytic choriomeningitis virus
QYNLSFSDA

SEQ ID NO: 61676 - protein, 9 aa, Lymphocytic choriomeningitis virus
CSQTSYQYL

SEQ ID NO: 61677 - protein, 9 aa, Lymphocytic choriomeningitis virus
MFEALPHII

SEQ ID NO: 61678 - protein, 9 aa, Lymphocytic choriomeningitis virus
IIITSIKAV

SEQ ID NO: 61679 - protein, 9 aa, Lymphocytic choriomeningitis virus
IYKGVYQFK

SEQ ID NO: 61680 - protein, 9 aa, Lymphocytic choriomeningitis virus
EFDMSHLNL

SEQ ID NO: 61681 - protein, 9 aa, Lymphocytic choriomeningitis virus
SYQYLIIQN

SEQ ID NO: 61682 - protein, 9 aa, Lymphocytic choriomeningitis virus
GILALVSFL

SEQ ID NO: 61683 - protein, 9 aa, Lymphocytic choriomeningitis virus
LALVSFLFL

SEQ ID NO: 61684 - protein, 9 aa, Lymphocytic choriomeningitis virus
KGVYQFKSV

SEQ ID NO: 61685 - protein, 9 aa, Lymphocytic choriomeningitis virus
SVNNSHHYI

SEQ ID NO: 61686 - protein, 9 aa, Lymphocytic choriomeningitis virus
IVSSLHLSI

SEQ ID NO: 61687 - protein, 9 aa, Lymphocytic choriomeningitis virus
KYMRSGWGW

SEQ ID NO: 61688 - protein, 9 aa, Lymphocytic choriomeningitis virus
SQTSYQYLI

SEQ ID NO: 61689 - protein, 9 aa, Lymphocytic choriomeningitis virus
QIVTMFEAL

SEQ ID NO: 61690 - protein, 9 aa, Lymphocytic choriomeningitis virus
INIVIIVLI

SEQ ID NO: 61691 - protein, 9 aa, Lymphocytic choriomeningitis virus
LTMPNACSV

SEQ ID NO: 61692 - protein, 9 aa, Lymphocytic choriomeningitis virus
NYKPVSCDF

SEQ ID NO: 61693 - protein, 9 aa, Lymphocytic choriomeningitis virus
TYAGPFRIS

SEQ ID NO: 61694 - protein, 9 aa, Lymphocytic choriomeningitis virus
VESPGGYCL

SEQ ID NO: 61695 - protein, 9 aa, Lymphocytic choriomeningitis virus
YCLTKWMIL

SEQ ID NO: 61696 - protein, 9 aa, Lymphocytic choriomeningitis virus
KWMILAAEL

SEQ ID NO: 61697 - protein, 9 aa, Lymphocytic choriomeningitis virus
SFLFLAGKS

SEQ ID NO: 61698 - protein, 9 aa, Lymphocytic choriomeningitis virus
FAQEKTKFL

SEQ ID NO: 61699 - protein, 9 aa, Lymphocytic choriomeningitis virus
TMFEALPHI

SEQ ID NO: 61700 - protein, 9 aa, Lymphocytic choriomeningitis virus
HIIDEVINI

SEQ ID NO: 61701 - protein, 9 aa, Lymphocytic choriomeningitis virus
IVIIVLIII

SEQ ID NO: 61702 - protein, 9 aa, Lymphocytic choriomeningitis virus
SVEFDMSHL

SEQ ID NO: 61703 - protein, 9 aa, Lymphocytic choriomeningitis virus
LTFTNDSIL

SEQ ID NO: 61704 - protein, 9 aa, Lymphocytic choriomeningitis virus
MSIVSSLHL

SEQ ID NO: 61705 - protein, 9 aa, Lymphocytic choriomeningitis virus
RGNSNYKPV

SEQ ID NO: 61706 - protein, 9 aa, Lymphocytic choriomeningitis virus
NGITIQYNL

SEQ ID NO: 61707 - protein, 9 aa, Lymphocytic choriomeningitis virus
LSFSDAQSA

SEQ ID NO: 61708 - protein, 9 aa, Lymphocytic choriomeningitis virus
TWENHCTYA

SEQ ID NO: 61709 - protein, 9 aa, Lymphocytic choriomeningitis virus
LFAQEKTKF

SEQ ID NO: 61710 - protein, 9 aa, Lymphocytic choriomeningitis virus
KTKFLTRRL

SEQ ID NO: 61711 - protein, 9 aa, Lymphocytic choriomeningitis virus
KFLTRRLAG

SEQ ID NO: 61712 - protein, 9 aa, Lymphocytic choriomeningitis virus
WTLSDSSGV

SEQ ID NO: 61713 - protein, 9 aa, Lymphocytic choriomeningitis virus
IIDEVINIV

SEQ ID NO: 61714 - protein, 9 aa, Lymphocytic choriomeningitis virus
IDEVINIVI

SEQ ID NO: 61715 - protein, 9 aa, Lymphocytic choriomeningitis virus
DEVINIVII

SEQ ID NO: 61716 - protein, 9 aa, Lymphocytic choriomeningitis virus
VINIVIIVL

SEQ ID NO: 61717 - protein, 9 aa, Lymphocytic choriomeningitis virus
NIVIIVLII

SEQ ID NO: 61718 - protein, 9 aa, Lymphocytic choriomeningitis virus
SIKAVYNFA

SEQ ID NO: 61719 - protein, 9 aa, Lymphocytic choriomeningitis virus
LFLAGKSCG

SEQ ID NO: 61720 - protein, 9 aa, Lymphocytic choriomeningitis virus
YISMGKSGL

SEQ ID NO: 61721 - protein, 9 aa, Lymphocytic choriomeningitis virus
ELTFTNDSI

SEQ ID NO: 61722 - protein, 9 aa, Lymphocytic choriomeningitis virus
HNHCNLTSA

SEQ ID NO: 61723 - protein, 9 aa, Lymphocytic choriomeningitis virus
NKKTFDHTL

SEQ ID NO: 61724 - protein, 9 aa, Lymphocytic choriomeningitis virus
FDHTLMSIV

SEQ ID NO: 61725 - protein, 9 aa, Lymphocytic choriomeningitis virus
CDFNNGITI

SEQ ID NO: 61726 - protein, 9 aa, Lymphocytic choriomeningitis virus
QYLIIQNRT

SEQ ID NO: 61727 - protein, 10 aa, Homo Sapiens
YLNDHLEPWI

SEQ ID NO: 61728 - protein, 9 aa, Artificial Sequence
  Synthesized
GLQHWVPEL

SEQ ID NO: 61729 - protein, 9 aa, Artificial Sequence
  Synthesized
GLAGDVSAV

SEQ ID NO: 61730 - protein, 9 aa, Human herpesvirus 5
NLVPMVATV
